United States Patent 9,958,448 (APTAMERS AND USES THEREOF) - sequence listing, part 18

SEQ ID NO: 240363 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcattttcactggaccacccgtgtta

SEQ ID NO: 240364 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagccatcttcatctggacacccgtgtta

SEQ ID NO: 240365 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgatagtcatcttcaccggacacccgtgtta

SEQ ID NO: 240366 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgatagccatcttcactggacacccgtgtta

SEQ ID NO: 240367 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcgtttgtccgtctccctgtggtattgcgcatgcc

SEQ ID NO: 240368 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcgtttgtccgtcctcttgtcggtattgcgcatgc

SEQ ID NO: 240369 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgttctcttgtggtattgcgcatac

SEQ ID NO: 240370 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgttctctcgtggtattgcgcatac

SEQ ID NO: 240371 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgttctctcgtggtattgcgcacgc

SEQ ID NO: 240372 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggttatgcgcatgc

SEQ ID NO: 240373 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcacacgc

SEQ ID NO: 240374 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggatatgcgcatcg

SEQ ID NO: 240375 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgcggtattgcgcgtgc

SEQ ID NO: 240376 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctagtggtattgcgcattc

SEQ ID NO: 240377 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtggtattgcgcttgc

SEQ ID NO: 240378 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgccctcttgtggtattgcgcatac

SEQ ID NO: 240379 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgccctcttgaggtattgcgcatgc

SEQ ID NO: 240380 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgctcgtctcttgtggtattgcgcatgcc

SEQ ID NO: 240381 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgctcgtcctcctgtggtattgcgcatgc

SEQ ID NO: 240382 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtcgtccttctcgtggtattgcgcatgtc

SEQ ID NO: 240383 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttctgtccgtctcttgtggtattgcgcatgc

SEQ ID NO: 240384 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttcgtccgtcctcttgtggtattgcgcgtgc

SEQ ID NO: 240385 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctgtccgtcctcttgtggtgttgcgcatgc

SEQ ID NO: 240386 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctgtccgtcctcttgtggtattgcgcatac

SEQ ID NO: 240387 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctgcccgtcctctcgtggtattgcgcatgc

SEQ ID NO: 240388 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccggttgtccgtcctctcgtggtattgcgcatgc

SEQ ID NO: 240389 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcttgtggtattgcgcatgt

SEQ ID NO: 240390 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcttgtgggattgcgcatgc

SEQ ID NO: 240391 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctctcgtggtattgcgcacgc

SEQ ID NO: 240392 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgctcgtcctcttgtggtattgcgcatgc

SEQ ID NO: 240393 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgcccgtcctctcgtggtattgcgcatgc

SEQ ID NO: 240394 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactactccgttgtccgtcctcttgtggtattgcgcatgc

SEQ ID NO: 240395 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattctagcgacttcggtggtgtcctctccattacca

SEQ ID NO: 240396 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaactccagcgacttcggtggtgtcctctccatcacca

SEQ ID NO: 240397 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgaggcttctggcactatccagttgacgctca

SEQ ID NO: 240398 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgcgaactgctgttttggcgccatccaaattttaggcta

SEQ ID NO: 240399 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgattccgctcatacatgcatgtaa

SEQ ID NO: 240400 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtctgaccctgttatggactaccatatcagaagggtact

SEQ ID NO: 240401 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acttccatctggtcgcgatacagaatacgattaacataaa

SEQ ID NO: 240402 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgctattccggtaagtcatcgtttaaccgcttgttgcaa

SEQ ID NO: 240403 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattcggtaagtcatcgtttaacccgtttgttgcaa

SEQ ID NO: 240404 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcttttaaccgtttgttgcaa

SEQ ID NO: 240405 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaaccgtgtgttgcaa

SEQ ID NO: 240406 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaaccgtatgttgcaa

SEQ ID NO: 240407 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgttcgaccgtttgttgcaa

SEQ ID NO: 240408 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttaactctgttgcttcgcgcgctatcgcgaatttagcgc

SEQ ID NO: 240409 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgtaccccgggttgcaattgcctcgtaaccataccgcat

SEQ ID NO: 240410 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgtaccccgggttgcaattgcctcgtaaccagaccgtat

SEQ ID NO: 240411 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttggggcttttaagcacttctcggtaacttgagcagttac

SEQ ID NO: 240412 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgggatacttgaggtcgttgagcgcttacgaaccctaat

SEQ ID NO: 240413 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgcacagctctcttcgtctttgatcgaccacgctcataa

SEQ ID NO: 240414 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgaatcctgctttaggcgcctcttaagggatccatttct

SEQ ID NO: 240415 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcttattcggcaggacgtctttcgtgcactatcacgatt

SEQ ID NO: 240416 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcttatccggcaggacgtctttcgcgcactatcacgatt

SEQ ID NO: 240417 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttctatccggctagacgtctttcgtgcactatcacgactt

SEQ ID NO: 240418 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcatcgcctagcttatgggactacccgtttgatgcctaa

SEQ ID NO: 240419 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttatccctgatgatctgagttctcatcggctggcactatc

SEQ ID NO: 240420 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttactttctcggtatcactaattgccgcatcacgcactcc

SEQ ID NO: 240421 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttaagatagtgcgttgggccgcctcgtttcctttcgtttg

SEQ ID NO: 240422 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgttcgccagtcacaccaactatgatgacgcttgactgga

SEQ ID NO: 240423 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgttcgccagccacatcaactatgatgacgcttgactggt

SEQ ID NO: 240424 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtggggctttaagcacttcttggtaacttgggcagttac

SEQ ID NO: 240425 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgcgactacgctcttgaacaattctgatccccggattt

SEQ ID NO: 240426 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtctcgtctacatactttcggacagtctcgccctccatg

SEQ ID NO: 240427 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtattgatcctctcgccgccgcctcgcacccattgcgcg

SEQ ID NO: 240428 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtagatcgtccttatccgcctcggtcttccccaggttaa

SEQ ID NO: 240429 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tggccttatatcgtgggggactacccccttgtgtgggtat

SEQ ID NO: 240430 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
tggacttatatcgtgggggactacccccttgtgtgggtat

SEQ ID NO: 240431 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcttatccggcaggacgtctttcgtgcactatcacgatt

SEQ ID NO: 240432 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcggacgtcaacgctgccttgttccttcaggtgccaccg

SEQ ID NO: 240433 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcggaacgctattttctgggaagccgcatcttgagcgaa

SEQ ID NO: 240434 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcacgcctctgattcactcctacagtgtgtctataga

SEQ ID NO: 240435 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaagcgctattttctgggaagccgcatctcgagccaa

SEQ ID NO: 240436 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaacgctattttcgtgggaagccgcatctcgagcgaa

SEQ ID NO: 240437 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaacgctatttctggaagccgctatcgtcgagctgaa

SEQ ID NO: 240438 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaacgctatttctcgggaaccgctatctcgagctgaa

SEQ ID NO: 240439 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgtctgatttctgggaaccgcgtctcgagcgaa

SEQ ID NO: 240440 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctgattttctgggaagccgcatctcgagcga

SEQ ID NO: 240441 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttttgggaagccgcatctcgagcgga

SEQ ID NO: 240442 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctggtaagccgcatctcgagcgaa

SEQ ID NO: 240443 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctggggagccgcgcctcgagcgaa

SEQ ID NO: 240444 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggatgccgcatctcgagcgaa

SEQ ID NO: 240445 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagtcgcgtctcgagcgaa

SEQ ID NO: 240446 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagctgcacctcgagcgaa

SEQ ID NO: 240447 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcgtctcgagctaa

SEQ ID NO: 240448 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcgtctagagcgaa

SEQ ID NO: 240449 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcgtcgcgagcgaa

SEQ ID NO: 240450 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatcttgagcgga

SEQ ID NO: 240451 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatctccagcgaa

SEQ ID NO: 240452 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgaatctcgagcgaa

SEQ ID NO: 240453 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagcagcatctcgagcgaa

SEQ ID NO: 240454 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttcggggaagccgcatctcgagcgaa

SEQ ID NO: 240455 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctatttgctgggaagccgcatctcgagcgaa

SEQ ID NO: 240456 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctatttctgggaaccgctgtcgtcgagcgaa

SEQ ID NO: 240457 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctatttctcgggaagccgcgtcttgagcgaa

SEQ ID NO: 240458 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattctctgggaagccgcatctcgagcaaa

SEQ ID NO: 240459 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctactttctgggaagccgcgtctcgagcgaa

SEQ ID NO: 240460 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctactttctgggaagccgcatttcgagcgaa

SEQ ID NO: 240461 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgcctatttctgggaagccgcgtctcgagcgaa

SEQ ID NO: 240462 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcctgattccggaacatgcacgtctcgtcttcgtccgcg

SEQ ID NO: 240463 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcagtccgcggtttcactagactactactgatcacgtcg

SEQ ID NO: 240464 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatttcccggggctcaccgcctctgtcttatagaatgcg

SEQ ID NO: 240465 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggcttttaagcacttccggtaacttgggcagttac

SEQ ID NO: 240466 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatggcttaaagcactttctgggataccgtggtcagtac

SEQ ID NO: 240467 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgactatcgttgtccgtcctcttgtcggtattgcgcatgc

SEQ ID NO: 240468 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgacgaaacgctatttctgggaaccgctgtctcgagcgaa

SEQ ID NO: 240469 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttcgctagactactactgatcacgtcg

SEQ ID NO: 240470 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttcattagactactactgatcacgtcg

SEQ ID NO: 240471 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttcactagactattactgatcacgtcg

SEQ ID NO: 240472 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttcactagactactgctgatcacgtcg

SEQ ID NO: 240473 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttcactagactactattgatcacgtcg

SEQ ID NO: 240474 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttcactagactactactgattacgtcg

SEQ ID NO: 240475 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttcactagactactactgatcacgttg

SEQ ID NO: 240476 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttcactagacaactactgatcacgtcg

SEQ ID NO: 240477 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggttacactagactactactaatcacgtcg

SEQ ID NO: 240478 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggattcactagactactactgatcacgtcg

SEQ ID NO: 240479 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaaatccgcggtttcactagactactactgatcacgtcg

SEQ ID NO: 240480 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccgtctggtcgcgatacagaatacgattaacataag

SEQ ID NO: 240481 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacggaatacgattaacataaa

SEQ ID NO: 240482 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacataatacgattaacataaa

SEQ ID NO: 240483 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacgatttacataaa

SEQ ID NO: 240484 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacgattagcataga

SEQ ID NO: 240485 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacgattaacgaaaa

SEQ ID NO: 240486 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacgattaacctaaa

SEQ ID NO: 240487 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacgagtaacataaa

SEQ ID NO: 240488 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatcaggtcgcgatacagaatacgattaacataaa

SEQ ID NO: 240489 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctctacgtccgaggacgtctttcgtgcactatcacgatt

SEQ ID NO: 240490 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctcccaagtttagttgtctttcgaggactacctcgtttc

SEQ ID NO: 240491 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctcccaagtttagtcgtctttcgaggactacctcgcttc

SEQ ID NO: 240492 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctccatctggtcgcgatatcagaatacgattaacataaa

SEQ ID NO: 240493 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgggatacttgaggtcgttgtgcgcttacgagccctaat

SEQ ID NO: 240494 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcggatacttgaggtcgctgcgtcgcttacgaaccctaat

SEQ ID NO: 240495 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcgcagctcacttcgtctttgatcggccacgctcataa

SEQ ID NO: 240496 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcctcaggttccccctaacgcgttagccttccggaatg

SEQ ID NO: 240497 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcactgctcacttcgtctttgatcaaccacgctcataa

SEQ ID NO: 240498 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcaccccgatagtcatcttcactggaccatccgtgtta

SEQ ID NO: 240499 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagttcacttcgtctttgatcaaccacgctcataa

SEQ ID NO: 240500 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagcttcacttcgtctttgatcgaccacgctctaa

SEQ ID NO: 240501 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcgcttcgtctttgatcggccacgctcataa

SEQ ID NO: 240502 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttggtcggccacgctcataa

SEQ ID NO: 240503 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcgaccacgctcatta

SEQ ID NO: 240504 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcgaccacgctcatgg

SEQ ID NO: 240505 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcgaccacgctcatac

SEQ ID NO: 240506 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcgaccacgctcacga

SEQ ID NO: 240507 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtcttgatcgaccactgctcataa

SEQ ID NO: 240508 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtcgttgatcgaccacgctcgtaa

SEQ ID NO: 240509 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgatctttgatcgacacgctcataa

SEQ ID NO: 240510 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagcctcacttcgtctttgatcgacacgctcataa

SEQ ID NO: 240511 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagcccacttcgtctttgatcgaccacgctcatga

SEQ ID NO: 240512 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgagctaacgctatttctcggaatcctgtcgtagctgac

SEQ ID NO: 240513 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccttcatggggtttttggggactaccccattggcaacac

SEQ ID NO: 240514 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccttatccggcaggacgtctttcgtgcactatcacgatt

SEQ ID NO: 240515 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcctccatctggtcgcgatacagaatacgattaacaaaaa

SEQ ID NO: 240516 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccgtctcgatcctacttttcgaaaaggtctattagctaa

SEQ ID NO: 240517 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccgagtccccaattcgtcgtccgtacgctattacggttt

SEQ ID NO: 240518 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccagaggccctcgtgttggactaccaacttgtagaacgg

SEQ ID NO: 240519 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatgggctttaagccacttctcgtaacttgggcagttac

SEQ ID NO: 240520 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatgggctttaagcacttctcggtaacttgggcggttac

SEQ ID NO: 240521 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatgggctttaagcacttctcggtaacttgggcagttgc

SEQ ID NO: 240522 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatcgctatccgctctccatcctcttgtgtatgctctgc

SEQ ID NO: 240523 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatcatggctgctcctctgccttattaggagccctaagg

SEQ ID NO: 240524 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcagtcgtgtcgtggactaccacagaagaatcgactgtcg

SEQ ID NO: 240525 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcagctgctcctccctgaaatcgtgttccctaacgttaag

SEQ ID NO: 240526 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcactattccggtaagtcatcgtttaaccgtttgttgcaa

SEQ ID NO: 240527 - skipped

SEQ ID NO: 240528 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcaaggcagtcggaacgctatttccggatttacgcgagac

SEQ ID NO: 240529 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatttgccagtcacatcaactatgatgacgcttggctgga

SEQ ID NO: 240530 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattctccagtcacatcaactatgatgacgcttgactgga

SEQ ID NO: 240531 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcggcagtcacatcaactatgatgacgcttgactgga

SEQ ID NO: 240532 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgctcagtacatcaactatgatgacgcttgactgga

SEQ ID NO: 240533 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgcctagtcacatcactatgatgacgcttgactgga

SEQ ID NO: 240534 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgcctagtcacatcaactatgatgacgcttggctga

SEQ ID NO: 240535 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccggtcgcatcaactatgatgacgcttgactgga

SEQ ID NO: 240536 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtctcatcaactatgatgacgcttgactgga

SEQ ID NO: 240537 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcgcatcaactatgatgacgcttggctgga

SEQ ID NO: 240538 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacttcaactatgatgacgcttgactgga

SEQ ID NO: 240539 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacgtcaactatgatgacgcatgactgga

SEQ ID NO: 240540 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacctcaactatgatgacgcttgactgga

SEQ ID NO: 240541 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcgaactattgactgactgctctga

SEQ ID NO: 240542 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcagctatgatgacgcttgtctgga

SEQ ID NO: 240543 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgtgtacgcttgactgga

SEQ ID NO: 240544 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatggcgacgcttgactgga

SEQ ID NO: 240545 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgcttgagtgga

SEQ ID NO: 240546 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgctctactgga

SEQ ID NO: 240547 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgctcgaccgga

SEQ ID NO: 240548 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgacgacgcttggctgga

SEQ ID NO: 240549 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgaagacgcttgactgga

SEQ ID NO: 240550 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaacgatgatgacgcttgactgga

SEQ ID NO: 240551 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacataaactatgatgacgcttggctgga

SEQ ID NO: 240552 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacataaactatgatgacgcttgactgga

SEQ ID NO: 240553 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatgaactatgatgacgcttgactgga

SEQ ID NO: 240554 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcagctatgatgacgcttgactaga

SEQ ID NO: 240555 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaattatgatgacgcttgactgga

SEQ ID NO: 240556 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgatgacgctttactgga

SEQ ID NO: 240557 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgatgacgcttggactga

SEQ ID NO: 240558 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
tattcgccagccacatcaactatgatgacgcttgcctgga

SEQ ID NO: 240559 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgatgacgcttgacggga

SEQ ID NO: 240560 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgatgacgctagactgga

SEQ ID NO: 240561 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgatgacccttgactgga

SEQ ID NO: 240562 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagcacatcaacctatgatgacgcttgactgga

SEQ ID NO: 240563 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagcacatcaaactatgatgacgcttgactgga

SEQ ID NO: 240564 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagacacatcaactatgatgacgcttgactggg

SEQ ID NO: 240565 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccaacacactcaactatgatgacgcttgactgga

SEQ ID NO: 240566 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgcagcctacatcaactatgatgacgcttgactgga

SEQ ID NO: 240567 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgcaagtcacatcaactatgatgacgcttgactgga

SEQ ID NO: 240568 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattccgccagccacatcaactatgatgacgcttgactga

SEQ ID NO: 240569 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggggttttaagctactctcgtagcttgggcagttac

SEQ ID NO: 240570 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggggcttttaagcacttctggtaacttgggcagtta

SEQ ID NO: 240571 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggggcttttaagcacttcgtgatacttgggcagtac

SEQ ID NO: 240572 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggggcttataagcacttcggtaacttgagcagttac

SEQ ID NO: 240573 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggggcttaagcacttctcggtaacttgggcagttac

SEQ ID NO: 240574 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttttaagcactctcgtaacttgggcagttac

SEQ ID NO: 240575 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttgagcacttccggtaacttgggcagttac

SEQ ID NO: 240576 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttagcacttctgggtaacttgggcagttac

SEQ ID NO: 240577 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttagagctctcgtgatacttgggcagttac

SEQ ID NO: 240578 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttagagacttctcggtaacttgggcattac

SEQ ID NO: 240579 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttagacacttctcggtaactgggcagttac

SEQ ID NO: 240580 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagctactctggatacttgggcagttac

SEQ ID NO: 240581 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcgcttctcgtgacttgggcagttac

SEQ ID NO: 240582 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcgcttctcgtaacttaggcagttac

SEQ ID NO: 240583 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttttcggtaacttgggcagtta

SEQ ID NO: 240584 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctggtaacttgggcagtcac

SEQ ID NO: 240585 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctggtaacttggacagttac

SEQ ID NO: 240586 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtattcgtggagttac

SEQ ID NO: 240587 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaacttggtgagtta

SEQ ID NO: 240588 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaacttaagcagtta

SEQ ID NO: 240589 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcgataacttgggcagtta

SEQ ID NO: 240590 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttcgtgacacttgggcagttac

SEQ ID NO: 240591 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttcgtcacttgggcagttaccc

SEQ ID NO: 240592 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttccggtaactcgggcagttac

SEQ ID NO: 240593 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcactctcggtaacctgggcagttac

SEQ ID NO: 240594 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcactcccggtaacttgggcagttac

SEQ ID NO: 240595 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcactacgtacgtacgtggcagttac

SEQ ID NO: 240596 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacctctcggtaacttggcagttac

SEQ ID NO: 240597 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttgagcacttctcggtaacttgggcagttaa

SEQ ID NO: 240598 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttatcacttctcggtaacttgggcgagttac

SEQ ID NO: 240599 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttactagacttctcgtaacttgggcagttac

SEQ ID NO: 240600 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttacagcacttctcggtaattgggcagttac

SEQ ID NO: 240601 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttacacacttctcggtaacttgagcagttac

SEQ ID NO: 240602 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcatttctcggtaacttgggcagttac

SEQ ID NO: 240603 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcactttctcgggtaacttggcagtac

SEQ ID NO: 240604 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacttgggcattacc

SEQ ID NO: 240605 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacttgggaagttac

SEQ ID NO: 240606 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacttgcgcagttac

SEQ ID NO: 240607 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacttgagtagttac

SEQ ID NO: 240608 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacttgagcagttgc

SEQ ID NO: 240609 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaactcgagcagttac

SEQ ID NO: 240610 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcactctcggtaacttgggcagttacc

SEQ ID NO: 240611 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttctagcacttcttggtaacttgggcagttac

SEQ ID NO: 240612 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcctttagcacttctcggtaacttgggcagttac

SEQ ID NO: 240613 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagctacttctcggtacttggcgagttac

SEQ ID NO: 240614 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcgagctctcgttacttgggcagttac

SEQ ID NO: 240615 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcgtacgttggtcgagttac

SEQ ID NO: 240616 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcactctcggtaacttgggcagttacc

SEQ ID NO: 240617 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttgagtcactcctcggtaacttggcgagttac

SEQ ID NO: 240618 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttcaagtcacttctcggtacttggcgagttac

SEQ ID NO: 240619 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttcaagcacttccgtcgtacttgggcagttac

SEQ ID NO: 240620 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttacacgcacttctcgtaacttgggcagttac

SEQ ID NO: 240621 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaatctacttctcggtaacttgggcagttac

SEQ ID NO: 240622 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagtcacttctcggtagcttgggcagttac

SEQ ID NO: 240623 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttctcgtaacttggtcgagttac

SEQ ID NO: 240624 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttctcggtacgttgggcagttac

SEQ ID NO: 240625 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttctcggtacgcttggcagttac

SEQ ID NO: 240626 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttcctcgtacttggcgagttacc

SEQ ID NO: 240627 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttccgtcgtacttgggcagttac

SEQ ID NO: 240628 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcactttctcggtaacttgagcagttac

SEQ ID NO: 240629 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacttggtcgagttac

SEQ ID NO: 240630 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacttggccagttacc

SEQ ID NO: 240631 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacttggacgagttac

SEQ ID NO: 240632 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacttgaggcagttac

SEQ ID NO: 240633 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacttgagcagttacc

SEQ ID NO: 240634 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttactacgcacttctcgtaacttgggcagttac

SEQ ID NO: 240635 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcgttttagcacttctcggtaacttgggcagttac

SEQ ID NO: 240636 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcctttaagctacttcggtaacttgggctagttac

SEQ ID NO: 240637 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggactttaagctacttctcggtaacttggcagttac

SEQ ID NO: 240638 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggcttaaagctatttctcgggatacctggtcagctac

SEQ ID NO: 240639 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggcgttttaagcacttctcggtaacttggacagttac

SEQ ID NO: 240640 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggagcttttaagcactttctcggtaacttggcagtac

SEQ ID NO: 240641 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgagcctgtcttttaatctcggcagagtgctcatgagc

SEQ ID NO: 240642 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcgccagtcacatcacttatgactacgcttgactacga

SEQ ID NO: 240643 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcgccagccacatccaactatgatgacgcttgactgga

SEQ ID NO: 240644 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatccgccagttacatcaactatgatgacgcttgactgga

SEQ ID NO: 240645 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatccgccagccacatcaactatgatgacgcttgactggg

SEQ ID NO: 240646 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagtgatgcgaggaccatggacttgcgtccctctatg

SEQ ID NO: 240647 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcagagtgctcatgtgc

SEQ ID NO: 240648 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcagagtgctcataagc

SEQ ID NO: 240649 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcagagtgcgcatgagc

SEQ ID NO: 240650 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcagagagctcatgagc

SEQ ID NO: 240651 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcgcagagtgctcatgagtc

SEQ ID NO: 240652 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcgacagagtgctcatgagc

SEQ ID NO: 240653 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatatcggcagagtgctcatgagc

SEQ ID NO: 240654 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtctttaatctcggtcagtagtgctcagagc

SEQ ID NO: 240655 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtctttaatctcggcagaggtgctcatgagc

SEQ ID NO: 240656 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttgtaatctcggcagagtgctcatgagc

SEQ ID NO: 240657 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcatttaatctcggcagagtgctcatgagc

SEQ ID NO: 240658 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagccctgtcttttaatctcggcagagtgctcatgag

SEQ ID NO: 240659 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagccagtcttttaatctcggcagagtgctcatgagc

SEQ ID NO: 240660 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagttcgatccgactttcaggcgctatcctgatcacccga

SEQ ID NO: 240661 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtcgatccgtgctttcaggcgctatcctgatcacccga

SEQ ID NO: 240662 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtcgatccgtactttcaggcgctatctgatcaccccga

SEQ ID NO: 240663 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtcgatccgtactttcaggcgctatcctgatcacctga

SEQ ID NO: 240664 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtcgaaccgtactttcaggcgctatcctgatcacccga

SEQ ID NO: 240665 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagggctttaagctacttctcggtaacttgggcgagttac

SEQ ID NO: 240666 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagggctttaagctacttcctccgtacttggcgagttacc

SEQ ID NO: 240667 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagggctttaaagcactttctcgggatacctggcagtaac

SEQ ID NO: 240668 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taggcggttttaagcacttctcggtaacttgggcggttac

SEQ ID NO: 240669 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taggcggtttacagcacttctcggtaacttgggcagttac

SEQ ID NO: 240670 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taggcggtttaagagacttctcggtaacttgggcagttac

SEQ ID NO: 240671 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagcggcttttaagcacttctcggtaactcgggcagttac

SEQ ID NO: 240672 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgtttgtccgtcctctcatggtattgcgcatgc

SEQ ID NO: 240673 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgtttgtccgtccccttgtggtattgcgcatgc

SEQ ID NO: 240674 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgtttgtccgtactcctgtggtattgcgcatgc

SEQ ID NO: 240675 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgacatcgagagagctacgtcatcaagcgctaa

SEQ ID NO: 240676 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccccatcgagcgatcgtcgtgatactgcttccaa

SEQ ID NO: 240677 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccccatcgagcgatcgtcgtaatactgcttccaa

SEQ ID NO: 240678 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactacccgtttgtccgtcctctcgtggtattgcgcatgc

SEQ ID NO: 240679 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactacccccatcgagcgagtctactcccccatcaacggg

SEQ ID NO: 240680 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacgtacgtgagattgcctcgctactctcttttgcagctg

SEQ ID NO: 240681 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacggggcttttaagcacttctcggtaactgggcagttac

SEQ ID NO: 240682 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacggaagtcccctcctcgtcttgatgcactatcatctca

SEQ ID NO: 240683 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacgaaacactattttctgggaagccgcatctcgagcgaa

SEQ ID NO: 240684 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacctccaccgcctcgtaagcccgggcactcacctctgta

SEQ ID NO: 240685 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccggtactggaggcgtccttggtggactaccacctcat

SEQ ID NO: 240686 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
taccggcactagaggcgtccttggtggactaccaccttat

SEQ ID NO: 240687 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccggaagtcccccctcgtcttgatgcactatcatctca

SEQ ID NO: 240688 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtataagttggctg

SEQ ID NO: 240689 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcagcggacacgacgtgtatcagttggctg

SEQ ID NO: 240690 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgccacatcatcggacacgacgtgtatcagttggctg

SEQ ID NO: 240691 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgaaagtccctcctcgtcttgatgcactatcatctca

SEQ ID NO: 240692 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccatccgtttgtccgtcctctcgtggtattgcgcatgc

SEQ ID NO: 240693 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccacctcatcatcggacacggcgtgtatcagttggctg

SEQ ID NO: 240694 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacagtagccctcgtgttggactaccaacttgtagagcgg

SEQ ID NO: 240695 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacagaggccctcgtgttgggctaccaacttgtagaacgg

SEQ ID NO: 240696 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacagaggccctcgtgttggactaccaacttgtggaacgg

SEQ ID NO: 240697 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacagaggccctcgtgttggactaccaacttgtagagtgg

SEQ ID NO: 240698 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacagaggccctcgtgttggaccaccaacttgtagaacgg

SEQ ID NO: 240699 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacacaggtgttaattgcctccggtccttccatgtgcaca

SEQ ID NO: 240700 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacaagcctgtcttttaatctcggcggagtgctcatgagc

SEQ ID NO: 240701 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taaggggcttttaagcacttctcggtaactggacagttac

SEQ ID NO: 240702 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taagggctttaagctacttctcggtaacttgggcagttac

SEQ ID NO: 240703 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taacttgcgcgcttaggtacctggtcactcctgcacgggt

SEQ ID NO: 240704 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taacggggccccgcctcaagctagctacctccattgtctg

SEQ ID NO: 240705 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taaccggggcccgcctcaggctagctacctccattgtctg

SEQ ID NO: 240706 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctctcggatcataaactcctgggtcatcgtccatacc

SEQ ID NO: 240707 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatgggtcgaaccggtatgcatg

SEQ ID NO: 240708 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtccacatggttcgaaccggtatgcatg

SEQ ID NO: 240709 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtccacatggttcgaaccgggatgcatg

SEQ ID NO: 240710 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctatgtcctcatggttcgaaccggcatgcatg

SEQ ID NO: 240711 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttcatggtacgcctcgattccgcccatacatgcatgtga

SEQ ID NO: 240712 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttatctctcggatcacacctcctggtcacgcccggtcgt

SEQ ID NO: 240713 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgtgtacagcctgcctcggttccttctgagctacgtaga

SEQ ID NO: 240714 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgtctcggatcgattaatttttcgcatccctcctgcacg

SEQ ID NO: 240715 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgtaatcgattcactgcgcctcggtccaaccatgcgttg

SEQ ID NO: 240716 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgcgaactgctgttttggcgctatccaaattttaggcta

SEQ ID NO: 240717 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgatgggccttttaagcacttctcgtacttggcagttac

SEQ ID NO: 240718 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgatcatgtaaagccggcttgctcgcctcggtcctccat

SEQ ID NO: 240719 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcttatccggcaggacgtctttcgtgcactatcacgatg

SEQ ID NO: 240720 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcttatccggcaggacgtctttcgtgcactatcacgatc

SEQ ID NO: 240721 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcttatccggcagaacgtctttcgtgcactatcacgatt

SEQ ID NO: 240722 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtctcggtcgcagcgaaaatactactccgaatcgcactcc

SEQ ID NO: 240723 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccacctgacatcgcggggaagctaatggtt

SEQ ID NO: 240724 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctgacatcgcggggaactaatggct

SEQ ID NO: 240725 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgccttgatcctcacataatatgatacgtctg

SEQ ID NO: 240726 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctggatcctcgcataatatgatacgtctg

SEQ ID NO: 240727 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgccatatacgatacgtctg

SEQ ID NO: 240728 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcattatatgacacgtctg

SEQ ID NO: 240729 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcatgatatgatacgtatg

SEQ ID NO: 240730 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatacgatacgtatg

SEQ ID NO: 240731 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataacatggtacgtctg

SEQ ID NO: 240732 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaagtcgcctcgattccgcccatacatgcatgtaaa

SEQ ID NO: 240733 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcccgccttgatcctcagtcctacccaggttgcaactta

SEQ ID NO: 240734 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggttcgcctcgattccgcccatacatgcatgtaa

SEQ ID NO: 240735 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtgcgcctcgattccgcccacacatgcatgtaa

SEQ ID NO: 240736 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgtttccgcccatacatgcatgtaa

SEQ ID NO: 240737 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcggttccgcccatacaagcatgtaa

SEQ ID NO: 240738 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattcgccccatacatgcatgaaa

SEQ ID NO: 240739 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcttatacatgcatgtaa

SEQ ID NO: 240740 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatagtgtcatgtaa

SEQ ID NO: 240741 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacatgcatctaa

SEQ ID NO: 240742 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgccataccatgcatgtaa

SEQ ID NO: 240743 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccacccatacatgcatgtga

SEQ ID NO: 240744 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgatcccgcccatacatgcatgtta

SEQ ID NO: 240745 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgatcccgcccaaacatgcatgtaa

SEQ ID NO: 240746 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcccccgattcgcccatacatgcatgtaa

SEQ ID NO: 240747 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacccctcgattccgcccatacatgcatgtaa

SEQ ID NO: 240748 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccacggtacgcctcgattccgcctatacatgcatgtaa

SEQ ID NO: 240749 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcagtccttccccgtcccgaactcatgtgcatgcatgcc

SEQ ID NO: 240750 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtattcgcctagtcacatcaactatgatgacgctgctgga

SEQ ID NO: 240751 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatgggcttttaagctacttctcgtacttggcgagttac

SEQ ID NO: 240752 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatgggcttttaagcacttctcgtaacttgggcagttac

SEQ ID NO: 240753 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatgggcttttaagcacttctcggtacttgggcagttac

SEQ ID NO: 240754 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatgggcttctacgtcacttctcgtacttgggcagttac

SEQ ID NO: 240755 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatgggcctttaagctacttctcggtacttggcagttac

SEQ ID NO: 240756 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatctttatccgccccctctgcatggtaggcctacatcg

SEQ ID NO: 240757 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtactccggatgagccacctcgcattcctccgttcgtctg

SEQ ID NO: 240758 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtacgactcccgttgcgcaccttgtacatacgtatgtccg

SEQ ID NO: 240759 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaccggggcccgcctcaagctagctacctccattgtctg

SEQ ID NO: 240760 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaataaccttccgttactcgcctcgggcaagtgtgcgcg

SEQ ID NO: 240761 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaagtcctctattaggttgccaccctatatctctgtgca

SEQ ID NO: 240762 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaagtattcacgttgaatcgccttgctcctcttagtctg

SEQ ID NO: 240763 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaaatattgacgttgaatcgccttgctcctcttagtctg

SEQ ID NO: 240764 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaaatattcacgttgaatcgccttgctcctcttagtcgg

SEQ ID NO: 240765 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaaatattcacgttgaatcgccttgctcctctcagtctg

SEQ ID NO: 240766 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaaatattcacgttgaaccgccttgctcctcttcgtctg

SEQ ID NO: 240767 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaaaaattcacgttgaatcgccttgctcctcttagtctg

SEQ ID NO: 240768 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggggttctttctcctgactacatgagattaataaacgcgc

SEQ ID NO: 240769 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggggtgtctgatatgctgttatatttttggaacctctctt

SEQ ID NO: 240770 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggggctttcttcatggactaccatgttacaaaaggtcata

SEQ ID NO: 240771 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggcgtttcttctcctgactacatgagattaataaacgcgc

SEQ ID NO: 240772 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggcggtttcttctctgactacatgagattaataacgcgcc

SEQ ID NO: 240773 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggaagtccgcggtttcactagactactactgatcacgtcg

SEQ ID NO: 240774 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcttaggctttcacgcacgcggattgtaccgaactgggtt

SEQ ID NO: 240775 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctgcatgggtcggttttggtgggggactacccccttgta

SEQ ID NO: 240776 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctcttatccggtcagacgcctttcgtgcactatcacgat

SEQ ID NO: 240777 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggcttttacgcacgcggattgtacccgagctgagtt

SEQ ID NO: 240778 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgtacgcggattgtacccgaattgggtt

SEQ ID NO: 240779 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgttcccgaactgggtt

SEQ ID NO: 240780 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgtaccgaactggggtt

SEQ ID NO: 240781 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgtacccgtactgggtt

SEQ ID NO: 240782 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgtacccaaactaggtt

SEQ ID NO: 240783 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggactgtacccgaactaggtt

SEQ ID NO: 240784 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacacacgcggattgtacccgaactgggtt

SEQ ID NO: 240785 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggatttcacgcacgcggattgtacccgaactgggtt

SEQ ID NO: 240786 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaccatcgtcgatgcgtggcatgttcgtcggaattcga

SEQ ID NO: 240787 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaccatcgtcaagctgtgtcagtttgtcagatcattgc

SEQ ID NO: 240788 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttgcttctctgactacatgagagttaataaacgcgc

SEQ ID NO: 240789 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttgcttctcctgactacatgggattaataaacgcgc

SEQ ID NO: 240790 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttgcttctcctgactacatgagattaataaatgcgc

SEQ ID NO: 240791 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttgcttctcctgactacatgagattaataaacgcac

SEQ ID NO: 240792 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttcttctcctgactacatgagtattaataaacgcgc

SEQ ID NO: 240793 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttcttctcctgactacatgagattaattaaacgcgc

SEQ ID NO: 240794 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttcttctcctgactacatgagattaataaacgcgcc

SEQ ID NO: 240795 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttcgctctcctgactacatgagattaataaacgcgc

SEQ ID NO: 240796 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgttgcttctcctgactacatgagtagttaataaacgcg

SEQ ID NO: 240797 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgttgcttctcctgactacatgagagttaataaacgcgc

SEQ ID NO: 240798 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgttcttctccttgactcacatgagtattaataacgcgc

SEQ ID NO: 240799 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgttcttctccttgactcacatgagattagtaaacgcgc

SEQ ID NO: 240800 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgttcttctcctgactacatgagattaacctaaacgcgc

SEQ ID NO: 240801 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttgcttctcctgactacatgagataataaacgcgc

SEQ ID NO: 240802 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttctttctctgactacatgagattaataaacgcgc

SEQ ID NO: 240803 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctggctacatgagattactaaacgcgc

SEQ ID NO: 240804 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctggctacatgagattaataagcgcgc

SEQ ID NO: 240805 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctggctacatgagattaataaacgtgc

SEQ ID NO: 240806 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctggctacatgagattaataaacgcgt

SEQ ID NO: 240807 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacctgagattaataaacgcgc

SEQ ID NO: 240808 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgggatcaataaacgcgc

SEQ ID NO: 240809 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgaggttaataaacacgc

SEQ ID NO: 240810 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgaggtcaataaacgtgc

SEQ ID NO: 240811 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattagtgaacgcgc

SEQ ID NO: 240812 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattagtagacgcgc

SEQ ID NO: 240813 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattactaaacgcgc

SEQ ID NO: 240814 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
gcggtttcttctcctgactacatgagattaataacagcgc

SEQ ID NO: 240815 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattaataaacgggc

SEQ ID NO: 240816 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattaacaaacgcac

SEQ ID NO: 240817 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattaaataacgcgc

SEQ ID NO: 240818 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagatgaataaacgcgc

SEQ ID NO: 240819 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagataaataaacgtgc

SEQ ID NO: 240820 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgaccacatgggattaataaacgcgc

SEQ ID NO: 240821 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctccctgactacatgagattaataaacgcg

SEQ ID NO: 240822 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctccctactacatgagattaataaacgcgc

SEQ ID NO: 240823 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcccgactacataagatcaataaacgcgc

SEQ ID NO: 240824 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctactgactacatgagattaataaacgcgc

SEQ ID NO: 240825 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttcgcctgactacatgagattaataaacgcgc

SEQ ID NO: 240826 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttcctcgtactacatgagattaataaacgcgc

SEQ ID NO: 240827 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttcccctgactacatgtgattaataaacgcgc

SEQ ID NO: 240828 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttctctcctggctacatgagattaatcaaacgcgc

SEQ ID NO: 240829 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttctctcctgcctacatgagattaataaaccgcgc

SEQ ID NO: 240830 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcctctcctgactacatgagattaataagcgcgc

SEQ ID NO: 240831 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcctctcctgactacatgagattaacaaacgcgc

SEQ ID NO: 240832 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttcttctcctcgaccacatgagattaataaacgcgc

SEQ ID NO: 240833 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttctctcctgactacattgagattaataaaccgcgc

SEQ ID NO: 240834 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttccttctcctgactacatgagattaacaaacgcgc

SEQ ID NO: 240835 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtcttcttctctgactacatgagattaacaaacgcgc

SEQ ID NO: 240836 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgggtctttattgtcgtctttgtaggactacctgcatca

SEQ ID NO: 240837 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgggtcttaattgtcgtctttgtaggactacctgcatca

SEQ ID NO: 240838 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggcttctcctcctgactacatgagattaataaacgcgc

SEQ ID NO: 240839 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgcgtacgccttggttttcctgggtacccccgccgtttg

SEQ ID NO: 240840 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgcctcgttcctacgcgttgatcaacctaccttcggctg

SEQ ID NO: 240841 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgcctcgaacactgacgtcgtggaaccttcgattgctag

SEQ ID NO: 240842 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgattcttctccttgactacatgagattaataaacgcgc

SEQ ID NO: 240843 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgtcagtctcgtcttcccatcgtctgcacttgacggac

SEQ ID NO: 240844 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcggtttttggtgggggactaccccttgta

SEQ ID NO: 240845 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcataggtcggttttggtgggggactacccccttgta

SEQ ID NO: 240846 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgaacctgtggctgtttgcgactacccaattagggcta

SEQ ID NO: 240847 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccgttgattgtctccattcggtcttaaggtacgaccgt

SEQ ID NO: 240848 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccggaacgcctcgatcctcgcatagtatgatacgtctg

SEQ ID NO: 240849 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccagtccttcctctcggatctaactgtacggctccgcac

SEQ ID NO: 240850 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccaggctttcacgcacgcggattgtacccgaactgggtt

SEQ ID NO: 240851 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcatcctccttaagtcgggcccatgtatatactatcgcac

SEQ ID NO: 240852 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcagtttcttctcctgactgcatgagattaataaacgcgc

SEQ ID NO: 240853 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcagattcgtttgttgcccgcctcgcaagcgcgttaggtt

SEQ ID NO: 240854 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcagaataaattcctcccactgctcgcctcgcatgctatg

SEQ ID NO: 240855 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcactattccggtaagtcatcgtttaaccatttgttgcaa

SEQ ID NO: 240856 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcactattccggtaagtcatcgtctaaccgtttgttgcaa

SEQ ID NO: 240857 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcactatcgtttcgtcgtcctacttgtggtattgcgcatg

SEQ ID NO: 240858 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcactatccgtttgtcgtcctcttgtggtattgcgcatgc

SEQ ID NO: 240859 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcactatccgtttgtccgtcctcttgtggtattgcgcatg

SEQ ID NO: 240860 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcactatccgtttgtccgtcctcttgtggtatgcgcatgc

SEQ ID NO: 240861 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcactatccgtttgtccgtcctctgtggtattgcgcatgc

SEQ ID NO: 240862 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcacctatccgttgtccgtcctctcgtgtattgcgcatgc

SEQ ID NO: 240863 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcaatttcttctcctgactacatgagattaataaacgcgc

SEQ ID NO: 240864 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcaagattcatctttgcttgactacacacaattccgatga

SEQ ID NO: 240865 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatttgttttactaactcttgcccattgaacacgttcccg

SEQ ID NO: 240866 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatgtccatgagcttctggcacttatccagttgacgctca

SEQ ID NO: 240867 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatctcgagatcactaggcactatcctagcactgtatcaa

SEQ ID NO: 240868 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcggcgccgagtaactctatactgcactatcagtttgt

SEQ ID NO: 240869 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcccgccttacgtaatcccttacgtttaacgccggcta

SEQ ID NO: 240870 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttagggcctttatacaaacgca

SEQ ID NO: 240871 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggtccttatacaaacgca

SEQ ID NO: 240872 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgattaaggcctttatacaaacgca

SEQ ID NO: 240873 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgccgccctttgtttagggcctttatacaaacgca

SEQ ID NO: 240874 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaggtacatgatcgcgtttacagactactgtaattttagc

SEQ ID NO: 240875 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggatctggcgtgctacttggacaggttccttc

SEQ ID NO: 240876 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gactacccgtttgtccgtcctcttgtggtattgcgcatgc

SEQ ID NO: 240877 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gacgtacttaccaccctggcatcgcggggaactaatggtt

SEQ ID NO: 240878 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gacggtcttctctctgactacacgagattaataaacgcgc

SEQ ID NO: 240879 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gacggccttccaatcctccttgtctgcagttcctgccctg

SEQ ID NO: 240880 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaactggatcctcgcctccatgctacgtggatttagattt

SEQ ID NO: 240881 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaactggatcctcgcctccatactacgtggattttgattt

SEQ ID NO: 240882 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaactggatcctcgcctccatactacgtagatttagattt

SEQ ID NO: 240883 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaactggactcctcgcctccatactacgtggatttagatt

SEQ ID NO: 240884 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccggggcccgcctcaagctagctacctccattgtcta

SEQ ID NO: 240885 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccggggccccgctcaagctagctacctccattgtctg

SEQ ID NO: 240886 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccggatcctcgcctccatactacgtggatttagattt

SEQ ID NO: 240887 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaaccggggcccgcctcaagctagctactccattgtctg

SEQ ID NO: 240888 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaaccggggcccgcctcaagctagctacctccttgtctg

SEQ ID NO: 240889 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttgggaagcggaactggtcgaggcgctatcctcgactta

SEQ ID NO: 240890 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttcgtcgtcgtgcaataaccttcagtggctggcgctatc

SEQ ID NO: 240891 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttcctcggatcttcaacatattgccgccgcgcatccgac

SEQ ID NO: 240892 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgtagtgattcctagaggctcctagtggctgggactacc

SEQ ID NO: 240893 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcctctgctctccctctcggatcacgtacgtggatatg

SEQ ID NO: 240894 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcctccaactccagggaacatgtcaccccgtttgtctg

SEQ ID NO: 240895 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcccctgctctccctctcggatcgcgtacgtggatatg

SEQ ID NO: 240896 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcaccccgatagtcatcttcactggaccacccgtgata

SEQ ID NO: 240897 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttgtcgggcaggacgtctttcgtgcactatcacgatt

SEQ ID NO: 240898 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttgtccggcaggacgtctttcgtgcgctatcacgatt

SEQ ID NO: 240899 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttgtccggcaggacgtctttcgtacactatcacgatt

SEQ ID NO: 240900 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttattcggcaggacgtcattcgtgcactatcacgatt

SEQ ID NO: 240901 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatctggcaggacgtctttcgtgcgctatcacgatt

SEQ ID NO: 240902 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatcggacaggacgtctttcgtgcactatcacgatt

SEQ ID NO: 240903 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatcgaggcaggactctttcgtgcactatcacgatt

SEQ ID NO: 240904 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccgtcaggacgtttttcgtgcactatcacgatt

SEQ ID NO: 240905 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccgtcaggacgcctttcgtgcattatcacgatt

SEQ ID NO: 240906 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtcagtcgtccttcttgcgattacgcatgt

SEQ ID NO: 240907 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtcaggacgtctttcgttgcatatcacgat

SEQ ID NO: 240908 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtcagacgtccttcgtgcactatcacgatt

SEQ ID NO: 240909 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtagggcgtctttcgtgcactatcacgatt

SEQ ID NO: 240910 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtaggacgtcttttgtgcactatcacgatt

SEQ ID NO: 240911 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccgggaggacgcctttcgtgcactatcacgatt

SEQ ID NO: 240912 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcgggacgtctttcgtgctctatcacgatt

SEQ ID NO: 240913 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcgggacgtctttcgcgcgctatcacgatt

SEQ ID NO: 240914 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcagggtgtctttcgtgcactatcacgatt

SEQ ID NO: 240915 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcagggcgtgtttcgtgcactatcacgatt

SEQ ID NO: 240916 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggatgtctttcgtgcactatcacgatc

SEQ ID NO: 240917 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtttctcgtgcactatcacgatt

SEQ ID NO: 240918 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcgttatcacgatt

SEQ ID NO: 240919 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcgctatcacgata

SEQ ID NO: 240920 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcactatcatggtt

SEQ ID NO: 240921 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgggcactatcacgatt

SEQ ID NO: 240922 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtcttcgtcgcactatcacgatt

SEQ ID NO: 240923 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctctcgcgcactatcacgatt

SEQ ID NO: 240924 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgcctttcgtgcactgtcacgatt

SEQ ID NO: 240925 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacatctttcgtgcgctatcacgatt

SEQ ID NO: 240926 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcagcaggacgttcttgcactatcacgatt

SEQ ID NO: 240927 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcagcacgtctttcgtgcactatcacgatt

SEQ ID NO: 240928 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcagacggtcttcgttgcactatcacgatt

SEQ ID NO: 240929 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccgagcaggacttcttcgtgcactatcacgatt

SEQ ID NO: 240930 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccgacggggcgtctttcgtgcactatcacaatt

SEQ ID NO: 240931 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccgacaggacgtcttttgtgcactatcacgatt

SEQ ID NO: 240932 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccgacaggacgtctttcgtgcactatcatgatt

SEQ ID NO: 240933 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccgacaggacgtctttcgtgcactaccacgatt

SEQ ID NO: 240934 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccagcaggacgtctttcgtgcactatcacgatc

SEQ ID NO: 240935 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccagcaggacgtctttcgtgcactatcacaatt

SEQ ID NO: 240936 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccagcaggacgtctttcgtgcactaacacgatt

SEQ ID NO: 240937 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatcaggcaggacgtcttccgtgcactatcacgatt

SEQ ID NO: 240938 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatacggcaggacatctttcgtgcactatcacgatt

SEQ ID NO: 240939 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttacgtcgcaggacgtctttcgtgcactatcacgatt

SEQ ID NO: 240940 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttacgtccgaggacgcctttcgtgcactatcacgatt

SEQ ID NO: 240941 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttacccggccggacgtctttcgtgcactatcacgatt

SEQ ID NO: 240942 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
ctcttacccggcaggacgtctttcgtgcgctatcacgatt

SEQ ID NO: 240943 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttacccggcaggacgtctttcgtgcactatcacgatc

SEQ ID NO: 240944 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctcggatcatttgcctcgcacctcctaaagttggatgg

SEQ ID NO: 240945 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctcatccggcagggcgtctttcgtgcactatcacgatt

SEQ ID NO: 240946 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctcatccggcaggacgtctttcgtgcgctatcacgatt

SEQ ID NO: 240947 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctcatccggcaggacgtctttcgtgcactatcacgatc

SEQ ID NO: 240948 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctatccgggcaggacgtctttcgtgcactatcacgatt

SEQ ID NO: 240949 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctccttatccggcaggactctttcgtgcactatcacgatt

SEQ ID NO: 240950 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcctacccggcaggacgtctttcgtgcactatcacgatt

SEQ ID NO: 240951 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctccgtagatgcgcacttatgggggctgcctgtgtcacac

SEQ ID NO: 240952 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctaccttcgtctagcgattcgcggtttctgttactaagta

SEQ ID NO: 240953 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctaaaatcttcccgggccgcctcgaagactttgaaatgcg

SEQ ID NO: 240954 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgttggaagactactttcattttagctgccagctgtcctc

SEQ ID NO: 240955 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgttggaagactactttcattttagccgccagctgctctc

SEQ ID NO: 240956 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgttatccgtttgtccgtcctcttgtggtattgcgcatgc

SEQ ID NO: 240957 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggtttcttctccttgactacatgagattaataaacgcgc

SEQ ID NO: 240958 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggttcttctcctgactacatgagattaataaacgcgccc

SEQ ID NO: 240959 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggttcgtttctcctgactacatgagattaatagacgcgc

SEQ ID NO: 240960 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggctaacgttcatcgagggagcgaaaggtctatagacta

SEQ ID NO: 240961 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctttgatcctcttatgcagtcctccctggcctcgttcg

SEQ ID NO: 240962 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcttgtacaattactcctcgacttccctggtataccacg

SEQ ID NO: 240963 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatctgtttgtccgtcctcttgtggtattgcgcatgc

SEQ ID NO: 240964 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatctgtcatcgagcgagcactttgtgtgatcacaca

SEQ ID NO: 240965 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatctgtcatcgagcgagcactttgtgcgttcacaca

SEQ ID NO: 240966 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatctgtcatcgagcgagcactttgcgcgatcacaca

SEQ ID NO: 240967 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatctgacatcgagcgagcactttgtgcgatcacaca

SEQ ID NO: 240968 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtctcttgtggtattgcgcatgcc

SEQ ID NO: 240969 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtctctcgtggtattgcgcatgcc

SEQ ID NO: 240970 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtccttttgtggtattgcgcatgc

SEQ ID NO: 240971 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtcctcttgtggtattgcgcatgt

SEQ ID NO: 240972 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtcctcttgtggtattgcgcatga

SEQ ID NO: 240973 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtcctcttgtggtattgcgcaggc

SEQ ID NO: 240974 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtcctcttgaggtattgcgcatgc

SEQ ID NO: 240975 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtcctctcgtggtattgcgcaagc

SEQ ID NO: 240976 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgttgtccgtcctcttgtggtattgcgcatgtc

SEQ ID NO: 240977 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtcatcgagcggttcttcgatgatatgcaaca

SEQ ID NO: 240978 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcttgagcgtttctcctgctcggttatcctga

SEQ ID NO: 240979 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcgtcgagcgggttcttcgataatatgcaacg

SEQ ID NO: 240980 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcccatcgagcgaacagtgtgcgctttcggtg

SEQ ID NO: 240981 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccatcgagcgagcactttgtgcgatcacaca

SEQ ID NO: 240982 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccatcgagcgaacagtgtgctgttttcggcg

SEQ ID NO: 240983 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccatcgagcgaacagtgtgccgttctcggtg

SEQ ID NO: 240984 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgacatcgagggagctacgtcatcaagcgctaa

SEQ ID NO: 240985 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccacatcgagcgggttcttcgataatatgcaaca

SEQ ID NO: 240986 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctacccgtttgtccgtcctctcgtggtattacgcatgc

SEQ ID NO: 240987 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctacccgaatcgagcttgagtgcctggttaaacaacga

SEQ ID NO: 240988 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccggaagtccctcctcgtcttggtgcactatcatctca

SEQ ID NO: 240989 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccggaagtccctcctcgtcttgatgcactatcatccca

SEQ ID NO: 240990 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccggaagtccctcctcgtcttgatgcactatcacctca

SEQ ID NO: 240991 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcacccccgatagtcatcttcgctggacaccccgcgtta

SEQ ID NO: 240992 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcaccccccgatagtcatcttcgctggaccaccgcgtta

SEQ ID NO: 240993 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgagcaaaaacaccctccctggttgcaaccgcctcgtctg

SEQ ID NO: 240994 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgactatccgtttgtccgcctctcgtggtattgcgcatgc

SEQ ID NO: 240995 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgaattatcagggactaccctgacgcaatattcacacgct

SEQ ID NO: 240996 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccttccagggcccaatgccgcattaccatcctatgttctg

SEQ ID NO: 240997 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcgtatcttccggtgaataccacgtacgtacatgtctg

SEQ ID NO: 240998 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcgtatcttccggtaattaccacgtacgtacacgtctg

SEQ ID NO: 240999 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtacttgtcgcaccttgtacttggcggctgacgctatt

SEQ ID NO: 241000 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtaccccgatagtcgtcttcgctggaccacccgtgtta

SEQ ID NO: 241001 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgggtcttattgtcgtcatttgtaggactacctgcatca

SEQ ID NO: 241002 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgggtcattattgtcgtctttgtaggactacctgcgtca

SEQ ID NO: 241003 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccggcctcaggttccctaactgcgttagccttccggaatg

SEQ ID NO: 241004 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttagttgctctctctcggatcaagtgttaaccatg

SEQ ID NO: 241005 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctctttcttctctccggacggtaccaagtgtagcta

SEQ ID NO: 241006 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctctgttcacccgtggaacgttcctttaaccggtta

SEQ ID NO: 241007 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctctcggatcagtaacgtctcgatcctcccactggc

SEQ ID NO: 241008 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgtacgttccctaacgcgttagccttccggaatg

SEQ ID NO: 241009 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcggtttacttccaggacgcgtccgactagtctgg

SEQ ID NO: 241010 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactgacgtcgtggaatcttcgattgctag

SEQ ID NO: 241011 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactgacgtcgtggaaccttggattgctag

SEQ ID NO: 241012 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactgacgtcgtggaaccttcgattgttag

SEQ ID NO: 241013 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactgacgtcgtggaaccttcgattactag

SEQ ID NO: 241014 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaaaactgacgtcgtggaaccttcgattgctag

SEQ ID NO: 241015 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctccaggtactgcagaccagagctctcagtactgcg

SEQ ID NO: 241016 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcagtttccccctaacgcgttagccttccggaatg

SEQ ID NO: 241017 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaacgcgttagccattccggaatg

SEQ ID NO: 241018 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttccccctaacgcgctagccttccggaatg

SEQ ID NO: 241019 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcagcattcccctaacgcgttagccttccggaatg

SEQ ID NO: 241020 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaagttccctaagtattacacgtgcacgtgactg

SEQ ID NO: 241021 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccgccccgatagtcatcttcactggacacccgtgtta

SEQ ID NO: 241022 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccccccgatagtcatcttcactggaccacccgtgtta

SEQ ID NO: 241023 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccaccccgatagtcatcttcactggacacccgtgttg

SEQ ID NO: 241024 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcatcccgatagtccatcttcactggacacccgtgtta

SEQ ID NO: 241025 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcatcccgatagtcatcttcgctggaccacccgtgtta

SEQ ID NO: 241026 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcactccgatagtcatcttcactggaccacccgtgtca

SEQ ID NO: 241027 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacctcgattagtcatcttcactggacacccgtgtta

SEQ ID NO: 241028 - skipped

SEQ ID NO: 241029 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacctcgatggtcatcttcgctggaccacccgcgtta

SEQ ID NO: 241030 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccctgattagtcatcttcactggacacccgtgtta

SEQ ID NO: 241031 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccctgatagtcatcttcgctggaccacccgtgtta

SEQ ID NO: 241032 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccctgatagtcatcttacgctggaccaccgcgtta

SEQ ID NO: 241033 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccctgacagtcatcttcactggaccacccgtgtta

SEQ ID NO: 241034 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccgattagtcatcttcgctggaccacctgcgtta

SEQ ID NO: 241035 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccgatagttcatcttcactggaccacccgtgtta

SEQ ID NO: 241036 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccgatagtcatcttcgctggaccaccccgcgtta

SEQ ID NO: 241037 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccgacttagtccatcttcactggacaccgtgtta

SEQ ID NO: 241038 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccgacttagtcatcttcactggacacctgtgtta

SEQ ID NO: 241039 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccctgactagccatcttcgctggaccaccgcgta

SEQ ID NO: 241040 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgttagtcatcttcgctggaccacccgcgtta

SEQ ID NO: 241041 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccggtagtcgtcttcgctggaccacccgtgtta

SEQ ID NO: 241042 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcgtcttcactggtccacccgtgtta

SEQ ID NO: 241043 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatctttcactggaccaccgtgtta

SEQ ID NO: 241044 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcgctggaccacccgcgata

SEQ ID NO: 241045 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcgcgggaccacccgcgtta

SEQ ID NO: 241046 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttccctggaccacccgcgtta

SEQ ID NO: 241047 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactgtaccacccgtgtta

SEQ ID NO: 241048 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactgggccacccgcgtta

SEQ ID NO: 241049 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggaccgccgccgtgt

SEQ ID NO: 241050 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggaccacccgggtta

SEQ ID NO: 241051 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcacgggaccacccgtgtta

SEQ ID NO: 241052 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcaacttcactggaccacccgtgtta

SEQ ID NO: 241053 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgatagttatcttcactggacacccgtgtta

SEQ ID NO: 241054 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgatagtcattctcactggacacccgtgtta

SEQ ID NO: 241055 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgatagtcatcttcgctggacacccgcgtta

SEQ ID NO: 241056 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgatagtcatcttcactggaccacccgtgta

SEQ ID NO: 241057 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgatagtcatcttcactgaacacccgtgtta

SEQ ID NO: 241058 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgatagtcaccttcactggacacccgtgtta

SEQ ID NO: 241059 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgataatcatcttcactggacacccgtgtta

SEQ ID NO: 241060 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccccgacagtcatcttcactggacaccgtgtta

SEQ ID NO: 241061 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccaatagtcatcttcactggacacccgtgtta

SEQ ID NO: 241062 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccaatagtcgtcttcgctggaccacccgtgtta

SEQ ID NO: 241063 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccttatccggcaggacgtctttcgtgcactatcacggtt

SEQ ID NO: 241064 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccttatccggcaggacgtctttcgtgcactatcacgatc

SEQ ID NO: 241065 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
cccttatccggcaagacgtctttcgagcactatcacgatt

SEQ ID NO: 241066 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccctctatcgtcgtcggcgtagcacgctattgcttagaag

SEQ ID NO: 241067 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccctctatagtcgtcggcgtagcacgctattgcctagaag

SEQ ID NO: 241068 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccgtctcgatcctacttttcgaaaaggtctattagctaa

SEQ ID NO: 241069 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccgtctcgatcctacctttcgaaaaggcctattagctaa

SEQ ID NO: 241070 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccgtagtccttctccgaacggagccgaaattcggtacta

SEQ ID NO: 241071 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccgcctctgttctcttactaacgttaggaagttttacgt

SEQ ID NO: 241072 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccattgtgcgcttatggagccgggtaccttccagcaagg

SEQ ID NO: 241073 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccaagctttctcggactacctggataacagcttaggcgg

SEQ ID NO: 241074 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccattgtgcgcttatggagccgggtaccttcctagcaagg

SEQ ID NO: 241075 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccattgtgcgcttatggagccgggtaccttcccagcaagg

SEQ ID NO: 241076 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccattgtgcgcttatggagccgggtaccttccagcaaaca

SEQ ID NO: 241077 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccacagatcctgagaccatctcacaaagtgcacttgttta

SEQ ID NO: 241078 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattgtggacctcctttctcggatccaaacataattgcac

SEQ ID NO: 241079 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattcgccagtcacatcaactatgatgacgcctgactgga

SEQ ID NO: 241080 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattcgccagtaacatcaactatgatgacgcttgactgga

SEQ ID NO: 241081 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattcgccagccacatcaactatgatgacgcttgtctgga

SEQ ID NO: 241082 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattatccgtttgtccgccctcttgtggtattgcgcatgc

SEQ ID NO: 241083 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattatccgcttgtccgtcctcttgtggtattgcgcatgc

SEQ ID NO: 241084 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattatccgcttgtccgtcctcctgtggtattgcgcatgc

SEQ ID NO: 241085 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattatccgctcgtccgtcctcttgtggtattgcgcatgc

SEQ ID NO: 241086 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattactgggtttctccgatcctttcgtacctccctgccg

SEQ ID NO: 241087 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catgggctttaagctacttctcggtaacttgggcagttac

SEQ ID NO: 241088 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catgggctttaagcacttcgtcggtaacttgggcagttac

SEQ ID NO: 241089 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catgcgagtatccgccttgctccttcggtcgatgtacgta

SEQ ID NO: 241090 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catctatccgtttgtccgtcctctctggtattgcgcatgc

SEQ ID NO: 241091 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catcgctatccgttgtccacctcttgtgtatgctcatggc

SEQ ID NO: 241092 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catcaatctcctcaatgcgcgccttgtaaatgaaagcaga

SEQ ID NO: 241093 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catacctctcggattgtcccccagtatgaccgcgctacac

SEQ ID NO: 241094 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caggttcacgagtgaaaggctactttctcacgccggtgcg

SEQ ID NO: 241095 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caggttcacaaatgaaaggctactttctcacgccggtgcg

SEQ ID NO: 241096 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagctattgctcatcgggcgatcatctgaaagaatatttg

SEQ ID NO: 241097 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagctattccggtaagtcatcgtttaaccgtttgttgcaa

SEQ ID NO: 241098 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagctaacgttcatcgagggagcaaaaggtctataggcta

SEQ ID NO: 241099 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagcgtatcgtggtgggatcttagcacctccgacatataa

SEQ ID NO: 241100 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagcgtatcatggtggggtcttagcacctccgacatataa

SEQ ID NO: 241101 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
cacttgtccgtttgtccgtcctcttgtggtattgcgcagg

SEQ ID NO: 241102 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacttatccgttgtccgtcctcttggtgtattgcgcatgc

SEQ ID NO: 241103 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacttatccggcaggatgtctttcgtgcactatcacgatt

SEQ ID NO: 241104 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactgtccgtttgtccgtcctcttgtggtattgcgcacgc

SEQ ID NO: 241105 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactgtccgcttgtccgtcttcttgtggtattgcgcatgc

SEQ ID NO: 241106 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactgtccgcttgtccgtcctcttgtggtattgcgcatgc

SEQ ID NO: 241107 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactattcgttttgtccgtcctcttgtggtattgcgctgc

SEQ ID NO: 241108 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactattcgtttgtccgtcctcttgtggcattgcgcatgc

SEQ ID NO: 241109 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactattcgcttgtccgtcctcttgtggtattgcgcatgc

SEQ ID NO: 241110 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcttgttcgtccgtcctcttgtgtatgcgcatcgc

SEQ ID NO: 241111 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatctgtttgtccgtcctcttgtggttttgcgcatgc

SEQ ID NO: 241112 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatctgtttgtccgtcctcctgtggtattgcgcatgc

SEQ ID NO: 241113 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatctgcttgtccgtcctcttgtggtattgcgcgtgc

SEQ ID NO: 241114 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcgtttgtccgtctcttcgtggtattgcgcatgcc

SEQ ID NO: 241115 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcgtttgtccgtcctcttgtggtcattgcgcatgc

SEQ ID NO: 241116 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcgtttgtccgtcctcttgtggtattgcgtcatgc

SEQ ID NO: 241117 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcgtttgtccgtcctctcgtggtattgcgcatgcc

SEQ ID NO: 241118 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcgttgttcgtccgtctcttggtgtatgcgcatcg

SEQ ID NO: 241119 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcgttgtccgtcctcttcgtcggtattgcgcatgc

SEQ ID NO: 241120 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcctttgtccgtcctcttgtggtaattgcgcatgc

SEQ ID NO: 241121 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcctcatcgagcgatcgtcgtaatactgcttccaa

SEQ ID NO: 241122 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcctattcgtccgtcctcttgtgttatgcgcatcg

SEQ ID NO: 241123 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttttgtccgtcctcttgtggtattgcgcata

SEQ ID NO: 241124 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttttgatctctctctccctctcaggcaaccg

SEQ ID NO: 241125 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgttcgtcctcttgtggcattgcgcatgc

SEQ ID NO: 241126 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgttccgtcctctgtggtattgcgcatgc

SEQ ID NO: 241127 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtgtgtcctcttgtggtattgcgcatgc

SEQ ID NO: 241128 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtgcgtcctcttgtggtattgcgcatgc

SEQ ID NO: 241129 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtctgtcctcttgtggtgttgcgcatgc

SEQ ID NO: 241130 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtctgtcctcttgtggtattgcgcatgt

SEQ ID NO: 241131 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtctgtcctctcgtggtattgtgcatgc

SEQ ID NO: 241132 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtcgtctcttgtggtattgcgcatcgcc

SEQ ID NO: 241133 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtcgtcctcttcgtggtattgcgcatgc

SEQ ID NO: 241134 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtcctcctcttgtggtaattgcgcatgc

SEQ ID NO: 241135 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgttttcttgtggtattgcgcatgc

SEQ ID NO: 241136 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgttctcccgtggtattgcgcatgc

SEQ ID NO: 241137 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcttctgtcggtattgcgcatgc

SEQ ID NO: 241138 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcttctagtggtattgcgcatgc

SEQ ID NO: 241139 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtctcttgtggtattgcgcgtgcc

SEQ ID NO: 241140 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtctcttgtggtattgcgcattgc

SEQ ID NO: 241141 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtctcttgtggtattcgcgcatgc

SEQ ID NO: 241142 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtctcttgtggtaattgcgcatgc

SEQ ID NO: 241143 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcgtctcgtggtattgcgcatgc

SEQ ID NO: 241144 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccttttgtggtattgcgcatac

SEQ ID NO: 241145 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctttcgtggtgttgcgcatgc

SEQ ID NO: 241146 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccttcttgtggtattgcgcatg

SEQ ID NO: 241147 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccttctcgtgacttgcgcatgc

SEQ ID NO: 241148 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctgttgtggtattgcgcatgc

SEQ ID NO: 241149 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttttggtattgcgcatac

SEQ ID NO: 241150 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtgttgcacatgc

SEQ ID NO: 241151 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgtgcgtgc

SEQ ID NO: 241152 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgtcgcatg

SEQ ID NO: 241153 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcgcgtac

SEQ ID NO: 241154 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcgcaaac

SEQ ID NO: 241155 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcacgtgc

SEQ ID NO: 241156 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtatctcgcatgc

SEQ ID NO: 241157 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtactgcgcatat

SEQ ID NO: 241158 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtaccgcgcatgc

SEQ ID NO: 241159 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtaatgcgcttgc

SEQ ID NO: 241160 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggcatcgcgcatgc

SEQ ID NO: 241161 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggatatacgcatgc

SEQ ID NO: 241162 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtgattttgcgcatgc

SEQ ID NO: 241163 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtgatattgcgtatgc

SEQ ID NO: 241164 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtagcattgcgcatgc

SEQ ID NO: 241165 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtagaattgcgcatgc

SEQ ID NO: 241166 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtaatactgcgcatgc

SEQ ID NO: 241167 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttggggtattgcgcgtgc

SEQ ID NO: 241168 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgcggtgttgcgcatgc

SEQ ID NO: 241169 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgcggtattgtgcatgc

SEQ ID NO: 241170 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgcggtattgcgcacgc

SEQ ID NO: 241171 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgcagtattgcgcatgc

SEQ ID NO: 241172 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgaggtcttgcgcatgc

SEQ ID NO: 241173 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgaggtatcgcgcatgc

SEQ ID NO: 241174 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgaggcattgcgcatac

SEQ ID NO: 241175 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttatggtattgtgcatgc

SEQ ID NO: 241176 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttatggtatcgcgcatgc

SEQ ID NO: 241177 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctgtggtcattgcgcatgc

SEQ ID NO: 241178 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctgtggtattgcgcagtgc

SEQ ID NO: 241179 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctggaggtattgcgcatgc

SEQ ID NO: 241180 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtgtattgtcgcatgc

SEQ ID NO: 241181 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtttgctgcatgc

SEQ ID NO: 241182 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtattgcggatgc

SEQ ID NO: 241183 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtattgcgcatcc

SEQ ID NO: 241184 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtatggcgcatgc

SEQ ID NO: 241185 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtactgcgcatac

SEQ ID NO: 241186 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggcattgcgcgtgc

SEQ ID NO: 241187 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggcattgcgcatac

SEQ ID NO: 241188 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtgatactgcgcatgc

SEQ ID NO: 241189 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtaatgttgcgcatgc

SEQ ID NO: 241190 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcagtgtatgcgcatcgc

SEQ ID NO: 241191 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctagcggtattgcgcatgc

SEQ ID NO: 241192 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcgtatggtattgcgcatgc

SEQ ID NO: 241193 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgttgtattgcgcatgc

SEQ ID NO: 241194 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtgtatatgcgcatcg

SEQ ID NO: 241195 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtggtatttcgcatgc

SEQ ID NO: 241196 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtggtattgcgtatgc

SEQ ID NO: 241197 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtggtattgcggatgc

SEQ ID NO: 241198 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtggtattgcgcattc

SEQ ID NO: 241199 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtgggattgcgcatgc

SEQ ID NO: 241200 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctctggtattgcgcatgc

SEQ ID NO: 241201 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcccgtggtgttgcgcatgc

SEQ ID NO: 241202 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcacgtagtattgcgcatgc

SEQ ID NO: 241203 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccctcttgtggtattgcgctgc

SEQ ID NO: 241204 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccccttgtggtgttgcgcatgc

SEQ ID NO: 241205 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccccttgtggtatttcgcatgc

SEQ ID NO: 241206 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccccttgtggcattgcgcatgc

SEQ ID NO: 241207 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccccttgcggtattgcgcatgc

SEQ ID NO: 241208 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcccctcgtggtattgcgcaagc

SEQ ID NO: 241209 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccccccgtggtattgcgcatgc

SEQ ID NO: 241210 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccacttatggtattgcgcatgc

SEQ ID NO: 241211 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccacctgtggtattgcgcatgc

SEQ ID NO: 241212 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgcccccttgtggtattgcgcatgc

SEQ ID NO: 241213 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgacctctcgtggtattgcgcatgc

SEQ ID NO: 241214 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtcccgtcctcttatggtattgcgcatg

SEQ ID NO: 241215 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccatcctcttgtggtattgcgtatgc

SEQ ID NO: 241216 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgctcgtcctcttgtggtactgcgcatgc

SEQ ID NO: 241217 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgcctgtcctcttgtggtattgcgcatgc

SEQ ID NO: 241218 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgcccgtgctcttgtggtattgcgcatgc

SEQ ID NO: 241219 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgcccgtcttcttgtggtattgcgcatgc

SEQ ID NO: 241220 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgcccgtcctcttgtggtattgcacatgc

SEQ ID NO: 241221 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgcccgtcctcttgtggtatggcgcatgc

SEQ ID NO: 241222 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgcccgtcctcttgtggtatcgcgcatgc

SEQ ID NO: 241223 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgcccgtcctctcgtggtattgcccatgc

SEQ ID NO: 241224 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgcccgtcctcacgtggtattgcgcatgc

SEQ ID NO: 241225 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgcccatcctctcgtggtattgcgcatgc

SEQ ID NO: 241226 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttcgtccgtctcttgtggtattgcgcatgc

SEQ ID NO: 241227 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttcgtccgtcccttgtggtattgcgcatgc

SEQ ID NO: 241228 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttatccgtcctcttgtggtgttgcgcatgc

SEQ ID NO: 241229 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttatccgtcctcttgtggtattgcgcacgc

SEQ ID NO: 241230 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtcgtcctcttgtcggtattgcgcatgcc

SEQ ID NO: 241231 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtccttctcgtcgtatgcgcatacg

SEQ ID NO: 241232 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtccttcctgtgtattgcgcatgtc

SEQ ID NO: 241233 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtgtacttgcgcatgtc

SEQ ID NO: 241234 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtggtattgtcgcatgc

SEQ ID NO: 241235 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtggtattgcgcatggt

SEQ ID NO: 241236 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtggtattgcgcactgc

SEQ ID NO: 241237 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtggtattcgcgcatgc

SEQ ID NO: 241238 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtcgtacttgcgcatgc

SEQ ID NO: 241239 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtcggtattgcgcatcg

SEQ ID NO: 241240 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtcggtattgcgcacgc

SEQ ID NO: 241241 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgctccgtcctctgtcgtactgcgcatcgc

SEQ ID NO: 241242 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttctatccgtcctctgtggtattgcgcatgc

SEQ ID NO: 241243 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttcgtccgtcctttcgtggtattgcgcatgc

SEQ ID NO: 241244 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttcgtccgtcctcttgtggtgttgcgcatgc

SEQ ID NO: 241245 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttcgcccgtcctctcgtggtattgcgcatgc

SEQ ID NO: 241246 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttatcgagcgttgtcgacagcggctaaggcc

SEQ ID NO: 241247 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttagtccgttctcttgtggtattgcgcatgc

SEQ ID NO: 241248 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttagatccgtcactcacgtactgcgtagtag

SEQ ID NO: 241249 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtcttgtccgtcctctgtggtattgcgcatgc

SEQ ID NO: 241250 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtcttgtccgtcctctgtggtattgcgcacgc

SEQ ID NO: 241251 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtcttctcgtcctcttgtggtattgcgcatgc

SEQ ID NO: 241252 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtcttagcgtgttcccttcggacatccatcaa

SEQ ID NO: 241253 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtcttaacgtgttccctcggacatccatcaaa

SEQ ID NO: 241254 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctgtcgtcctcttgtggtattgcgcatacg

SEQ ID NO: 241255 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctgtccgtcctcttgtggtattgcgaatgc

SEQ ID NO: 241256 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctgtccgtcctcttgtggtatcgcgcgtgc

SEQ ID NO: 241257 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctgtccgtcctctcgtggtattgcgcatcg

SEQ ID NO: 241258 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctgtccatcctcttgtggtattgcgcatgc

SEQ ID NO: 241259 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctgctcgtcctcttgtggtattgcgcatgc

SEQ ID NO: 241260 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgttatcaacaagcggctaaggcc

SEQ ID NO: 241261 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcactcattacgcgtatggaatc

SEQ ID NO: 241262 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccggttgtccgtcctcttgtggtgttgcgcatgc

SEQ ID NO: 241263 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccggttgtccgtcctcttgtggtactgcgcatgc

SEQ ID NO: 241264 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccggcaggacgtcttttcgtgcactatcacgatt

SEQ ID NO: 241265 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccttcctcctgtggtattgcgcatgc

SEQ ID NO: 241266 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcttcctgtggtattgcgcatgc

SEQ ID NO: 241267 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcttgttgtattgcgcatgc

SEQ ID NO: 241268 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcttgtggtattgggcatgc

SEQ ID NO: 241269 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcttgtggtattgcgcaggc

SEQ ID NO: 241270 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcttgtgggattgcgcacgc

SEQ ID NO: 241271 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcttgtggaattgcgcatgc

SEQ ID NO: 241272 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcttgtagtattgcgcatgc

SEQ ID NO: 241273 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctctcgtggtattgcacatgc

SEQ ID NO: 241274 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctctcgaggtattgcgcatgc

SEQ ID NO: 241275 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcatgtggtattgcgcatgc

SEQ ID NO: 241276 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtccccctgtggtattgcgcatgc

SEQ ID NO: 241277 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccatcctctcgtggtattgcgcatgc

SEQ ID NO: 241278 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttctccgtcctcttgtggtattgcgcatgc

SEQ ID NO: 241279 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttatgttcgcctctctctcggttacgcgtt

SEQ ID NO: 241280 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttatgttcgcctctctcccggttgcgcgtt

SEQ ID NO: 241281 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttatccgtcctcttgtggtattgcgcatgc

SEQ ID NO: 241282 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttatccgtcctctcgtggtattgcgcatgc

SEQ ID NO: 241283 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcctgctcgtcctcttgtggtattgcgcatgc

SEQ ID NO: 241284 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcatcgagctttcgtccgggagtgtatagctg

SEQ ID NO: 241285 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgacatcgagagcgctacgtcatcaagcgctaa

SEQ ID NO: 241286 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgacatcgagagagctacgtcatcaagcgctta

SEQ ID NO: 241287 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcccgtttgtccgtcctctgtggtattgcgcttgc

SEQ ID NO: 241288 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcccgtttgtcccgtcctctgtggtattgcgcatg

SEQ ID NO: 241289 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcccgtagatccgtcatctcactacgcgtatgact

SEQ ID NO: 241290 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccccatcgagcggtcgtcgtaatactgcttccaa

SEQ ID NO: 241291 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccccatcgagcgatcgtcgtaatgctgcttccaa

SEQ ID NO: 241292 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccatttgtccgtcctcttgtggtactgcgcatgc

SEQ ID NO: 241293 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccatttgtccgtcctctcgtagtattgcgcatgc

SEQ ID NO: 241294 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccaacatcgagagagctacgtcatcaagcgctaa

SEQ ID NO: 241295 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactaggttcgcctcgcgcctcctagtgcacgtttgtctg

SEQ ID NO: 241296 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactacttcgttgaccgtcctcttgtggtattgcgcatgc

SEQ ID NO: 241297 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactactccgttgtccgtcctcctgtggtattgcgcatgc

SEQ ID NO: 241298 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactacccgtttgtccgtcctcttgtggtattgcgcatac

SEQ ID NO: 241299 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactacccgtttgtccgtcctcttgtggtaatgcgcatgc

SEQ ID NO: 241300 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactacccgtttgtccgtcctctcgtggtgttgcgcatgc

SEQ ID NO: 241301 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactacccgtttgtccgtcctctcgtggtattgcgcttgc

SEQ ID NO: 241302 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactacccgtttatccgtcctcttgtggtattgcgcatgc

SEQ ID NO: 241303 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactacccgttcgtccgtcctcttgtggtattgcgcatgc

SEQ ID NO: 241304 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactacccgtagatccgtcactcaccacgcgtatggaatc

SEQ ID NO: 241305 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactacccgcttgtccgtcctctcgtggtattgcgcatgc

SEQ ID NO: 241306 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactacccgacatcgagagagctacgtcatcaagcgctaa

SEQ ID NO: 241307 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactaaccgtttgtccgtcctcttgtggtattgcgcatac

SEQ ID NO: 241308 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacggttatgtctgactttcaggcgctatcctgatttcgt

SEQ ID NO: 241309 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacctatccgtttgtccgtcctcttgtggtattgcgcatg

SEQ ID NO: 241310 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacctatccgtagatccgtcactcactacgcgtatgaatc

SEQ ID NO: 241311 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccggaagtccctcctcgtcttgatgcgctatcatctca

SEQ ID NO: 241312 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccggaagtccctcctcgtcttgatgcactatcatccca

SEQ ID NO: 241313 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccggaagtccctcctcgtcttaatgcactatcatctca

SEQ ID NO: 241314 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccggaagtccctcctcgtcgtgatgcactatcatctca

SEQ ID NO: 241315 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccatccgtttgtccgtcctcttgtggtgttgcgcatgc

SEQ ID NO: 241316 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccatccgtttgtccgtcctcttgtggtgttgcgcacgc

SEQ ID NO: 241317 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccatccgtttgtccgtcctcttgtggtattgcgcgtgc

SEQ ID NO: 241318 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccatccgtttgtccgtcctcttgtagtattgcgcatgc

SEQ ID NO: 241319 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccatccgtttgtccgtcctctcgtggtattgcgcacgc

SEQ ID NO: 241320 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccatccgtttgtccgtcctctcgtggtattacgcgtgc

SEQ ID NO: 241321 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccatccgtttgtccgtcctcctgtggtattgcgcatgc

SEQ ID NO: 241322 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccatccgtttgtccgtccccttgtggtgttgcgcatgc

SEQ ID NO: 241323 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccatccgtttgcccgtcctctcgtggtattgcgcatgc

SEQ ID NO: 241324 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccatccgtatgtccgtcctcttgtggtattgcgcatgc

SEQ ID NO: 241325 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccatccgtagatccgtcactcactacgcgtatggaatc

SEQ ID NO: 241326 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacacttacttccatcacgcctcgattctccctatcgctg

SEQ ID NO: 241327 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacaatccgtttatccgtcctcttgtggtattgcgcatgc

SEQ ID NO: 241328 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caatggatgtctatttcagagcgctatactctgatcaaaa

SEQ ID NO: 241329 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caatgcttgatctcctgtcgactctgcagctgagactact

SEQ ID NO: 241330 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caatgctagatctcctgtcgactctgcggctgagactact

SEQ ID NO: 241331 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caataatgtcctgtgtgcacagtgtaccttacgtttgctg

SEQ ID NO: 241332 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caaggcatgtcgttgcaagcctcgattccaaccacgtctg

SEQ ID NO: 241333 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atttttggccactcgatccgcctcgttttcttcgtctgcg

SEQ ID NO: 241334 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attgattcatattggtggcacactattgccttgaacttta

SEQ ID NO: 241335 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attgatccttattggtggcacactattgccttgaacttta

SEQ ID NO: 241336 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attctgtttttttaagttggcgaggtccctatactttggg

SEQ ID NO: 241337 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attctgttttttaagttggcgaggtcctctaacttttgag

SEQ ID NO: 241338 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attctgttttttaagttggcgaggtcccctaacttttggg

SEQ ID NO: 241339 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attccgtttagaagaatctgttggccactatgccatcaat

SEQ ID NO: 241340 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attccgcttagagaaatctgttggccactatgccatcaat

SEQ ID NO: 241341 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attcattccagcgacttcggtggtgtcctctccattacca

SEQ ID NO: 241342 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcgactttcggtggtgtcctctcattacca

SEQ ID NO: 241343 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcgacttctgtggtgtcctctccattacca

SEQ ID NO: 241344 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcgacttcggtggtgtcctctctattacca

SEQ ID NO: 241345 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcgacttcggtggtgtcctctccattatca

SEQ ID NO: 241346 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcgacttcggtggtgtcctctccattaccc

SEQ ID NO: 241347 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcgacttcgctggtgtcctctccattaccg

SEQ ID NO: 241348 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcgacttaggtggtgtcctctccattacca

SEQ ID NO: 241349 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattcagcgacttcggtggtgtccctctcattaccca

SEQ ID NO: 241350 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaatcccagcgacttcggcggtgtcctctccattacca

SEQ ID NO: 241351 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaactccagtcgacttcggtggtgtcctctcattacca

SEQ ID NO: 241352 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgttccagctgacgctctgacactatcatgacgtctcga

SEQ ID NO: 241353 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgttccactgacgctctgacactatcatgacgtgctcga

SEQ ID NO: 241354 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtgtcatatatctgactgcagattttgtcatggcacta

SEQ ID NO: 241355 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtgtcatatatctgactacagattttgtcatggcactg

SEQ ID NO: 241356 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtgtcatatatctgactacaaattttgtcatggcacta

SEQ ID NO: 241357 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgagtctctcggccactatccagttgacgctca

SEQ ID NO: 241358 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtatgaggtcctttgctgaactatcaccatttctggac

SEQ ID NO: 241359 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtttcttctcctgactacatgagattaataagcgcgc

SEQ ID NO: 241360 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggttccatgagcttctggcactatccagctgacgctca

SEQ ID NO: 241361 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggttcatgagcttctggcactatcccagttggcgctca

SEQ ID NO: 241362 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtggcttttaagcacttcttggtaacttggcagttac

SEQ ID NO: 241363 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtctatgctagctcgtgcactatccagttgacgctca

SEQ ID NO: 241364 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccgtgagtcttctggcactatccagttgacgctca

SEQ ID NO: 241365 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccgtgagcttctggcactatcccagttgacgctca

SEQ ID NO: 241366 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtcccatgagcttggcactatccccagttgacgctca

SEQ ID NO: 241367 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtcccatgagcttctggcactatccagctgacgctca

SEQ ID NO: 241368 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgggcttctggcactattccagttgacgctca

SEQ ID NO: 241369 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgggcttctggcaactatccagttgacgctca

SEQ ID NO: 241370 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagtcttctggcactgtccagttgacgctca

SEQ ID NO: 241371 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagtcttctggcactatccagttgacgccca

SEQ ID NO: 241372 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagtcttctggcactatccaattgacgctca

SEQ ID NO: 241373 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagtcttctggcactacccagttgacgctca

SEQ ID NO: 241374 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagtcttctggaactatccagttgacgctca

SEQ ID NO: 241375 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagtcttctcggcactatcagttgacgctca

SEQ ID NO: 241376 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgaggtcttctggcactatcagttgacgctcg

SEQ ID NO: 241377 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttcttggcatctatccagttgacgcta

SEQ ID NO: 241378 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcatctatccagctgacgctca

SEQ ID NO: 241379 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcactatccaggttgacgctca

SEQ ID NO: 241380 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcactactcctagtgacgctca

SEQ ID NO: 241381 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctcggcactatccagtcgacgctca

SEQ ID NO: 241382 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagctactggcactatcccagttgacgctca

SEQ ID NO: 241383 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggcccatgggcttctggcactatccagttggacgctca

SEQ ID NO: 241384 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgcgaaacgctattttctgggaaccgcgtctcgagcgaa

SEQ ID NO: 241385 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgcaaactgccgttttggcgctatccaaattttaggcta

SEQ ID NO: 241386 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgactgcaggcatttgcctcgtgtttgtatcacgtggga

SEQ ID NO: 241387 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgacctaccccatcgagcgagtctactctccatcaacgg

SEQ ID NO: 241388 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgaactgtggatcgtttacctctggactacccggggcaa

SEQ ID NO: 241389 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcttatccggctaggacgtctttcgtgcactatcacgat

SEQ ID NO: 241390 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atctccgtctaacacgtgcgctatcacggctttggttaga

SEQ ID NO: 241391 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atctccgtctaacacgtgcactatcacggctttagttagg

SEQ ID NO: 241392 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcgtcgggccccttttgtgaaacttacatgaaagcgtac

SEQ ID NO: 241393 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
atccgttctcgtataattcaggatggcttactatctagct

SEQ ID NO: 241394 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccgtggtacgcctcgattccgcccatacatgcatgtaa

SEQ ID NO: 241395 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcgcataatacgatacatctg

SEQ ID NO: 241396 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcaatcctcgcataatatgatacgtctg

SEQ ID NO: 241397 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccgcctcgcttgtgcacaacacgcatcccgcgtctgcg

SEQ ID NO: 241398 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgattccgcccatacaagcatgtaa

SEQ ID NO: 241399 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgattccgaccatacatgcatgtaa

SEQ ID NO: 241400 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccaaggtacgcctcgattccgcccatacatgcatgtaa

SEQ ID NO: 241401 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcaccgctgggtgaggagtcgttgtgcgctatcacatct

SEQ ID NO: 241402 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atatggggctttaagcacttctcggtaactcggcagttac

SEQ ID NO: 241403 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atactgtagttggtcgttttcgcaggactacctggagtgg

SEQ ID NO: 241404 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agttttctcggatccaagcgcatatcctcctccgcctcgt

SEQ ID NO: 241405 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agttttctcggatccaaacgcatatccttctccgcctcgt

SEQ ID NO: 241406 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agttttctcggatccaaacgcatatcctccgccgcctcgt

SEQ ID NO: 241407 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agttttctcggatccaaacgcacatcctcctccgcctcgt

SEQ ID NO: 241408 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtttcctcggatccaaacgcatatcctcctccgcctcgt

SEQ ID NO: 241409 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agttctagaacctgcctcaagccggcaatcacctcttctg

SEQ ID NO: 241410 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtcgtttcttctctgactacatgagattaataaacgcgc

SEQ ID NO: 241411 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtcattaatccttgttggactaccaccaaaaacgattag

SEQ ID NO: 241412 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agccgactcatcagggactaccctgtattcgagcaggcaa

SEQ ID NO: 241413 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agattctagattaaccgcctcggtcagctcagattgtgca

SEQ ID NO: 241414 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agatgggactacttgctcgactacgatcattgacgtcact

SEQ ID NO: 241415 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agactactccgatgggcaatcgtaacttaggagtcgccta

SEQ ID NO: 241416 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agaccggggcccgcctcaagctagctaccttcattgtctg

SEQ ID NO: 241417 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agaccggggcccgcctcaagctagctacctctattgtctg

SEQ ID NO: 241418 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agaccggggcccgcctcaagctagctacctccaatgtctg

SEQ ID NO: 241419 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agaccgggccccgctcaagctagtctactccacttgtctg

SEQ ID NO: 241420 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actctattccggtaagtcatcgtttaaccgtttgttgcaa

SEQ ID NO: 241421 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actctattccggtaagtcatcgtctaaccgtttgttgcaa

SEQ ID NO: 241422 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actaccttcgtccagcggtgcgctggggactttatccttc

SEQ ID NO: 241423 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actaccttcgtccagcggtgcgctgggaactttatccctc

SEQ ID NO: 241424 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actacccccccagtttagtccttcctaaagggccctttga

SEQ ID NO: 241425 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actaccccccagtttagtccttcctaaaaggggcctttga

SEQ ID NO: 241426 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actacagctttttcgtgttctccggaccacctgagatgac

SEQ ID NO: 241427 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgtaccccgatagtcatcttcgctggaccacccgcgtta

SEQ ID NO: 241428 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acggtttcttctcctgactacatgagattaatgaacgcgc

SEQ ID NO: 241429 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acggtttcttctcctgactacatgagattaacaaacgcgc

SEQ ID NO: 241430 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acggtttcttctcctgactacataagattaataaacgcgc

SEQ ID NO: 241431 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acggttctcttcctcgactacatgagattaataaacgcgc

SEQ ID NO: 241432 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acggtaggcacctgctctatgtcgtggggagtaacaggtt

SEQ ID NO: 241433 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgctttctcggatctatctcgtgcgcacatcctcataaa

SEQ ID NO: 241434 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgctattccggtaagtcatcgtctaaccgtttgttgcaa

SEQ ID NO: 241435 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acctatcttgacgtctcttcggggactacccctgattctg

SEQ ID NO: 241436 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgtcttgtgtgcgacacatgtctacgactcctcttcag

SEQ ID NO: 241437 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accggccacccgatagtcatcttcactggacaccgtgtta

SEQ ID NO: 241438 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accggcacccgatagtcatcttcacaggaccaccgtgtta

SEQ ID NO: 241439 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgcgtgggtcggttttggtgggggactatccccttgta

SEQ ID NO: 241440 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accctatcttgacgtctcttcggggactaccccgattccg

SEQ ID NO: 241441 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accctatcttgacgtctcttcggggactaccccgatcctg

SEQ ID NO: 241442 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accctatcttgacgtctctccggggactaccccgattctg

SEQ ID NO: 241443 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acccggagcgcctcgatcctcgcataatatgatacgtctg

SEQ ID NO: 241444 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagtgggttccatgctttaggcgccccttattttgggtc

SEQ ID NO: 241445 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagcactggactctcagcgcgcgacccatctcgtcagtg

SEQ ID NO: 241446 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagcactggaccctcagcgcgcgacccatctcgtcagta

SEQ ID NO: 241447 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattcggtaagtcatcgttcaacccgtttgttgcaa

SEQ ID NO: 241448 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtgagtcatcgtctaaccgtttgttgcaa

SEQ ID NO: 241449 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtctcgttaaccgtttttgttgcaa

SEQ ID NO: 241450 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcgtcgttcaaccgtttgttgcaa

SEQ ID NO: 241451 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtccatcgtttaccgtttgttgcaa

SEQ ID NO: 241452 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttgaccgtttgttgcag

SEQ ID NO: 241453 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttagccgcttgttgcaa

SEQ ID NO: 241454 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaacggtttgttgcaa

SEQ ID NO: 241455 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaaccgtttgttgcat

SEQ ID NO: 241456 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaaccgtttgttgcac

SEQ ID NO: 241457 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaaccgtttgtggcaa

SEQ ID NO: 241458 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaaccgtttgatgcaa

SEQ ID NO: 241459 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaaccgtctgtcgcaa

SEQ ID NO: 241460 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaaccgcttgttggaa

SEQ ID NO: 241461 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaaccgcttgttacaa

SEQ ID NO: 241462 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaaccgctcgttgcaa

SEQ ID NO: 241463 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgttcacctgtttgtgacaa

SEQ ID NO: 241464 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgttcaaccgtttgttgtaa

SEQ ID NO: 241465 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgttaccgttacgtttgtca

SEQ ID NO: 241466 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgttaaccgttcgttgtcag

SEQ ID NO: 241467 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtctgaccgtttgttgcaa

SEQ ID NO: 241468 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtctaaccgcttgtcgcaa

SEQ ID NO: 241469 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcggttaaccgtttgttgcaa

SEQ ID NO: 241470 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgcttaaccttttgttgcaa

SEQ ID NO: 241471 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgcctaaccgtttgttgcaa

SEQ ID NO: 241472 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcctctaaccgtttgttgcaa

SEQ ID NO: 241473 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagctcgttattacccgtttgttgcaa

SEQ ID NO: 241474 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggccttcaccgtcctcaatgcggacgaatg

SEQ ID NO: 241475 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggccttcaccgtcctcaatacggtcgaatg

SEQ ID NO: 241476 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggccttcaccgtcctcaatacggacgagtg

SEQ ID NO: 241477 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggccttcaccgacctcaatacggacgaatg

SEQ ID NO: 241478 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggccttcaccatcctcaatacggacgaatg

SEQ ID NO: 241479 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccgataagtcatcgtttaaccgtttgttgcaa

SEQ ID NO: 241480 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccgaccttcaccgtcctcaatacggacgaatg

SEQ ID NO: 241481 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattacggtaagtcatcgtttaaccgtttgttgcaa

SEQ ID NO: 241482 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactatgccggtaagtcatcgtttaaccgtttgttgcaa

SEQ ID NO: 241483 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactatccggtaagtcatcgtctaaccgtttcgttgcaa

SEQ ID NO: 241484 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactatcccggcaagtcatcgtttaaccgtttgttgcaa

SEQ ID NO: 241485 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acaccaacactctgtgtacgctggactacccgcgtttcaa

SEQ ID NO: 241486 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aattcgccagtcacatcaactatgatgacgcttggctgga

SEQ ID NO: 241487 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatggtccatgggcttctggcactatccagttgacgctca

SEQ ID NO: 241488 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatggggcttttaagcacttctcggtacttgggcagttac

SEQ ID NO: 241489 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgcgccagccacatcaactatgatgacgcttgactgga

SEQ ID NO: 241490 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatctgaccctgttatggactaccatatcagaaaggtact

SEQ ID NO: 241491 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagcgtttgtatgtgtcgcaccgctattgcgaggtaacat

SEQ ID NO: 241492 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagccggggcccgcctcaagctagctatctccattgtctg

SEQ ID NO: 241493 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagatctcggatctggcgtactacttgaacaggttccttc

SEQ ID NO: 241494 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagacctcggatctggcgtactacttggacaggttccttc

SEQ ID NO: 241495 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aactatccgtttgtccgtcctcttgtggtatcgcgcatgc

SEQ ID NO: 241496 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aactatccgtttgtccgtcctctagtggtattgcgcatgc

SEQ ID NO: 241497 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccggggccgcctcaagctagctacctccatttgtcctg

SEQ ID NO: 241498 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccggggcccgcctcaagtctagctacctccattgtctg

SEQ ID NO: 241499 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggccgctcaacgtctagctcacctccattgtcgtg

SEQ ID NO: 241500 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggccgcctcaacgctagctcacctccattgtcgtg

SEQ ID NO: 241501 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgcctcaagtctagctacttccattgtcgtg

SEQ ID NO: 241502 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggccccgctcaacgctagctcacctccattgtctg

SEQ ID NO: 241503 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aacccgggggccgcctcaagctagctacctccattgtctg

SEQ ID NO: 241504 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccatccacatcgagcgaatcgtgggtacaagtggatta

SEQ ID NO: 241505 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaatccgccttcgttcttccacgcaacgttgcagtctgcg

SEQ ID NO: 241506 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacggggccccgcttcaagctagctacctccattgtctg

SEQ ID NO: 241507 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacgggcccggcctcaacgctagctactccattcgtctg

SEQ ID NO: 241508 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacgagatctcatggcgcctcgggtccttccttcgactg

SEQ ID NO: 241509 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggtacgccttgtgtcgcccgtgtgttgcaaccaga

SEQ ID NO: 241510 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggtcccgcctcaagctagctacctccatgtctg

SEQ ID NO: 241511 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggggcccgcctcaagctagctacctccattgtcg

SEQ ID NO: 241512 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggggcccgcctcaagctagctacctccatctctg

SEQ ID NO: 241513 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggctcgcctcaagctagctacttccattgtctg

SEQ ID NO: 241514 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcctgcctcaagctagctacctccattatctg

SEQ ID NO: 241515 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggccgcctcaagctagctacctccagttgtctg

SEQ ID NO: 241516 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgctcaacgctagctacctccattgtctg

SEQ ID NO: 241517 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcgagttagctacctccattgtctg

SEQ ID NO: 241518 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctaggtacctccattgtctg

SEQ ID NO: 241519 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctatctccatcgtctg

SEQ ID NO: 241520 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctatatccattgtctg

SEQ ID NO: 241521 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctactcctattgtctg

SEQ ID NO: 241522 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctcctttgtccg

SEQ ID NO: 241523 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctcctattctcg

SEQ ID NO: 241524 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccgttgtcta

SEQ ID NO: 241525 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccatcatctg

SEQ ID NO: 241526 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagcaacccccattgtctg

SEQ ID NO: 241527 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggccccgcctcaagctagctactccactgtctg

SEQ ID NO: 241528 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagtctagctacctccattgtcgg

SEQ ID NO: 241529 - skipped

SEQ ID NO: 241530 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagccagcttacctccattctctg

SEQ ID NO: 241531 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggacccgcctctagctagctacctccattgtctg

SEQ ID NO: 241532 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggacccgcctcaagctagctacctccattgtttg

SEQ ID NO: 241533 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggagcccgcctcaagctagctacttccattgtctg

SEQ ID NO: 241534 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacccgggcccgcctcaagctagcaacctccattgtctg

SEQ ID NO: 241535 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaaccggggcccgcctcaagctactacctccattgtctg
